United States Patent 12,297,469 (METHODS AND COMPOSITIONS FOR INHIBITING ADAM10 BIOLOGICAL ACTIVITIES) - sequence listing, part 3

SEQ ID NO: 16123 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 16124 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 16125 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 16126 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 16127 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 16128 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 16129 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 16130 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 16131 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 16132 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 16133 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 16134 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 16135 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 16136 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 16137 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 16138 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 16139 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 16140 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 16141 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 16142 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 16143 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 16144 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 16145 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 16146 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 16147 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 16148 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 16149 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 16150 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 16151 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 16152 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 16153 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 16154 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 16155 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 16156 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 16157 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 16158 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 16159 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 16160 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 16161 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 16162 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 16163 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 16164 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 16165 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 16166 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 16167 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 16168 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 16169 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 16170 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 16171 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 16172 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 16173 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 16174 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 16175 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 16176 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 16177 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 16178 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 16179 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 16180 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 16181 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 16182 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 16183 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 16184 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 16185 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 16186 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 16187 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 16188 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 16189 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 16190 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 16191 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 16192 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 16193 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 16194 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 16195 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 16196 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 16197 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 16198 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 16199 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 16200 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 16201 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 16202 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 16203 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 16204 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 16205 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 16206 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 16207 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 16208 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 16209 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 16210 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 16211 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 16212 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 16213 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 16214 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 16215 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 16216 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 16217 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 16218 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 16219 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 16220 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 16221 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 16222 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 16223 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 16224 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 16225 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 16226 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 16227 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 16228 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 16229 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 16230 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 16231 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 16232 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 16233 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 16234 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 16235 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 16236 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 16237 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 16238 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 16239 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 16240 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 16241 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 16242 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 16243 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 16244 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 16245 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 16246 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 16247 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 16248 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 16249 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 16250 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 16251 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 16252 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 16253 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 16254 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 16255 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 16256 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 16257 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 16258 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 16259 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 16260 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 16261 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 16262 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 16263 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 16264 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 16265 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 16266 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 16267 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 16268 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 16269 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 16270 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 16271 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 16272 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 16273 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 16274 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 16275 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 16276 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 16277 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 16278 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 16279 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 16280 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 16281 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 16282 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 16283 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 16284 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 16285 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 16286 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 16287 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 16288 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 16289 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 16290 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 16291 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 16292 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 16293 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 16294 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 16295 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 16296 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 16297 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 16298 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 16299 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 16300 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 16301 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 16302 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 16303 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 16304 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 16305 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 16306 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 16307 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 16308 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 16309 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 16310 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 16311 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 16312 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 16313 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 16314 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 16315 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 16316 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 16317 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 16318 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 16319 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 16320 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 16321 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 16322 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 16323 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 16324 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 16325 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 16326 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 16327 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 16328 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 16329 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 16330 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 16331 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 16332 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 16333 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 16334 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 16335 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 16336 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 16337 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 16338 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 16339 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 16340 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 16341 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 16342 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 16343 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 16344 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 16345 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 16346 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 16347 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 16348 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 16349 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 16350 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 16351 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 16352 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 16353 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 16354 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 16355 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 16356 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 16357 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 16358 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 16359 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 16360 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 16361 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 16362 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 16363 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 16364 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 16365 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 16366 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 16367 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 16368 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 16369 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 16370 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 16371 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 16372 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 16373 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 16374 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 16375 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 16376 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 16377 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 16378 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 16379 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 16380 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 16381 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 16382 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 16383 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 16384 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 16385 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 16386 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 16387 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 16388 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 16389 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 16390 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 16391 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 16392 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 16393 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 16394 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 16395 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 16396 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 16397 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 16398 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 16399 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 16400 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 16401 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 16402 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 16403 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 16404 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 16405 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 16406 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 16407 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 16408 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 16409 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 16410 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 16411 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 16412 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 16413 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 16414 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 16415 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 16416 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 16417 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 16418 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 16419 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 16420 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 16421 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 16422 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 16423 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 16424 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 16425 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 16426 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 16427 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 16428 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 16429 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 16430 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 16431 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 16432 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 16433 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 16434 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 16435 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 16436 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 16437 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 16438 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 16439 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 16440 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 16441 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 16442 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 16443 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 16444 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 16445 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 16446 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 16447 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 16448 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 16449 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 16450 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 16451 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 16452 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 16453 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 16454 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 16455 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 16456 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 16457 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 16458 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 16459 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 16460 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 16461 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 16462 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 16463 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 16464 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 16465 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 16466 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 16467 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 16468 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 16469 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 16470 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 16471 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 16472 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 16473 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 16474 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 16475 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 16476 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 16477 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 16478 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 16479 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 16480 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 16481 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 16482 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 16483 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 16484 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 16485 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 16486 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 16487 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 16488 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 16489 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 16490 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 16491 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 16492 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 16493 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 16494 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 16495 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 16496 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 16497 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 16498 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 16499 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 16500 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 16501 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 16502 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 16503 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 16504 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 16505 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 16506 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 16507 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 16508 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 16509 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 16510 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 16511 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 16512 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 16513 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 16514 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 16515 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 16516 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 16517 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 16518 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 16519 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 16520 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 16521 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 16522 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 16523 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 16524 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 16525 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 16526 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 16527 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 16528 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 16529 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 16530 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 16531 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 16532 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 16533 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 16534 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 16535 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 16536 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 16537 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 16538 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 16539 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 16540 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 16541 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 16542 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 16543 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 16544 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 16545 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 16546 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 16547 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 16548 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 16549 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 16550 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 16551 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 16552 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 16553 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 16554 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 16555 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 16556 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 16557 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 16558 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 16559 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 16560 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 16561 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 16562 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 16563 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 16564 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 16565 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 16566 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 16567 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 16568 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 16569 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 16570 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 16571 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 16572 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 16573 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 16574 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 16575 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 16576 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 16577 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 16578 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 16579 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 16580 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 16581 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 16582 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 16583 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 16584 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 16585 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 16586 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 16587 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 16588 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 16589 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 16590 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 16591 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 16592 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 16593 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 16594 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 16595 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 16596 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 16597 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 16598 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 16599 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 16600 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 16601 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 16602 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 16603 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 16604 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 16605 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 16606 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 16607 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 16608 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 16609 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 16610 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 16611 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 16612 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 16613 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 16614 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 16615 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 16616 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 16617 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 16618 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 16619 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 16620 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 16621 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 16622 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 16623 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 16624 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 16625 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 16626 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 16627 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 16628 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 16629 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 16630 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 16631 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 16632 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 16633 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 16634 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 16635 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 16636 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 16637 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 16638 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 16639 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 16640 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 16641 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 16642 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 16643 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 16644 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 16645 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 16646 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 16647 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 16648 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 16649 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 16650 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 16651 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 16652 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 16653 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 16654 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 16655 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 16656 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 16657 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 16658 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 16659 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 16660 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 16661 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 16662 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 16663 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 16664 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 16665 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 16666 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 16667 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 16668 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 16669 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 16670 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 16671 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 16672 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 16673 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 16674 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 16675 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 16676 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 16677 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 16678 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 16679 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 16680 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 16681 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 16682 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 16683 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 16684 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 16685 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 16686 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 16687 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 16688 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 16689 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 16690 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 16691 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 16692 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 16693 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 16694 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 16695 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 16696 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 16697 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 16698 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 16699 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 16700 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 16701 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 16702 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 16703 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 16704 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 16705 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 16706 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 16707 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 16708 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 16709 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 16710 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 16711 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 16712 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 16713 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 16714 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 16715 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 16716 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 16717 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 16718 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 16719 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 16720 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 16721 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 16722 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 16723 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 16724 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 16725 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 16726 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 16727 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 16728 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 16729 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 16730 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 16731 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 16732 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 16733 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 16734 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 16735 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 16736 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 16737 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 16738 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 16739 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 16740 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 16741 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 16742 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 16743 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 16744 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 16745 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 16746 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 16747 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 16748 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 16749 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 16750 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 16751 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 16752 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 16753 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 16754 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 16755 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 16756 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 16757 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 16758 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 16759 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 16760 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 16761 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 16762 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 16763 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 16764 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 16765 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 16766 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 16767 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 16768 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 16769 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 16770 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 16771 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 16772 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 16773 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 16774 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 16775 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 16776 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 16777 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 16778 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 16779 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 16780 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 16781 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 16782 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 16783 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 16784 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 16785 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 16786 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 16787 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 16788 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 16789 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 16790 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 16791 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 16792 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 16793 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 16794 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 16795 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 16796 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 16797 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 16798 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 16799 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 16800 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 16801 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 16802 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 16803 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 16804 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 16805 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 16806 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 16807 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 16808 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 16809 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 16810 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 16811 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 16812 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 16813 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 16814 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 16815 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 16816 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 16817 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 16818 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 16819 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 16820 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 16821 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 16822 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 16823 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 16824 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 16825 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 16826 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 16827 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 16828 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 16829 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 16830 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 16831 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 16832 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 16833 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 16834 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 16835 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 16836 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 16837 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 16838 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 16839 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 16840 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 16841 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 16842 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 16843 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 16844 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 16845 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 16846 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 16847 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 16848 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 16849 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 16850 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 16851 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 16852 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 16853 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 16854 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 16855 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 16856 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 16857 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 16858 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 16859 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 16860 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 16861 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 16862 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 16863 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 16864 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 16865 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 16866 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 16867 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 16868 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 16869 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 16870 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 16871 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 16872 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 16873 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 16874 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 16875 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 16876 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 16877 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 16878 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 16879 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 16880 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 16881 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 16882 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 16883 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 16884 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 16885 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 16886 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 16887 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 16888 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 16889 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 16890 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 16891 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 16892 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 16893 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 16894 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 16895 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 16896 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 16897 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 16898 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 16899 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 16900 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 16901 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 16902 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 16903 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 16904 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 16905 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 16906 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 16907 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 16908 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 16909 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 16910 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 16911 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 16912 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 16913 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 16914 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 16915 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 16916 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 16917 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 16918 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 16919 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 16920 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 16921 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 16922 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 16923 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 16924 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 16925 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 16926 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 16927 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 16928 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 16929 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 16930 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 16931 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 16932 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 16933 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 16934 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 16935 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 16936 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 16937 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 16938 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 16939 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 16940 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 16941 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 16942 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 16943 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 16944 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 16945 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 16946 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 16947 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 16948 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 16949 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 16950 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 16951 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 16952 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 16953 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 16954 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 16955 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 16956 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 16957 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 16958 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 16959 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 16960 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 16961 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 16962 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 16963 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 16964 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 16965 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 16966 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 16967 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 16968 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 16969 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 16970 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 16971 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 16972 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 16973 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 16974 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 16975 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 16976 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 16977 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 16978 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 16979 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 16980 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 16981 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 16982 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 16983 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 16984 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 16985 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 16986 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 16987 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 16988 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 16989 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 16990 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 16991 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 16992 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 16993 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 16994 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 16995 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 16996 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 16997 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 16998 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 16999 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 17000 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 17001 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 17002 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 17003 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 17004 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 17005 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 17006 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 17007 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 17008 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 17009 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 17010 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 17011 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 17012 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 17013 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 17014 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 17015 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 17016 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 17017 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 17018 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 17019 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 17020 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 17021 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 17022 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 17023 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 17024 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 17025 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 17026 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 17027 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 17028 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 17029 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 17030 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 17031 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 17032 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 17033 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 17034 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 17035 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 17036 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 17037 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 17038 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 17039 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 17040 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 17041 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 17042 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 17043 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 17044 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 17045 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 17046 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 17047 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 17048 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 17049 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 17050 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 17051 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 17052 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 17053 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 17054 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 17055 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 17056 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 17057 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 17058 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 17059 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 17060 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 17061 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 17062 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 17063 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 17064 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 17065 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 17066 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 17067 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 17068 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 17069 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 17070 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 17071 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 17072 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 17073 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 17074 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 17075 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 17076 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 17077 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 17078 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 17079 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 17080 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 17081 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 17082 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 17083 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 17084 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 17085 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 17086 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 17087 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 17088 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 17089 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 17090 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 17091 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 17092 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 17093 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 17094 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 17095 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 17096 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 17097 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 17098 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 17099 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 17100 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 17101 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 17102 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 17103 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 17104 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 17105 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 17106 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 17107 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 17108 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 17109 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 17110 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 17111 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 17112 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 17113 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 17114 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 17115 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 17116 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 17117 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 17118 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 17119 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 17120 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 17121 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 17122 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 17123 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 17124 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 17125 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 17126 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 17127 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 17128 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 17129 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 17130 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 17131 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 17132 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 17133 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 17134 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 17135 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 17136 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 17137 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 17138 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 17139 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 17140 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 17141 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 17142 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 17143 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 17144 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 17145 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 17146 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 17147 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 17148 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 17149 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 17150 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 17151 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 17152 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 17153 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 17154 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 17155 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 17156 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 17157 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 17158 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 17159 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 17160 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 17161 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 17162 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 17163 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 17164 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 17165 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 17166 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 17167 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 17168 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 17169 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 17170 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 17171 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 17172 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 17173 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 17174 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 17175 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 17176 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 17177 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 17178 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 17179 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 17180 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 17181 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 17182 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 17183 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 17184 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 17185 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 17186 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 17187 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 17188 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 17189 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 17190 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 17191 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 17192 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 17193 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 17194 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 17195 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 17196 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 17197 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 17198 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 17199 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 17200 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 17201 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 17202 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 17203 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 17204 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 17205 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 17206 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 17207 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 17208 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 17209 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 17210 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 17211 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 17212 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 17213 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 17214 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 17215 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 17216 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 17217 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 17218 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 17219 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 17220 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 17221 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 17222 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 17223 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 17224 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 17225 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 17226 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 17227 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 17228 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 17229 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 17230 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 17231 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 17232 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 17233 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 17234 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 17235 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 17236 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 17237 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 17238 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 17239 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 17240 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 17241 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 17242 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 17243 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 17244 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 17245 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 17246 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 17247 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 17248 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 17249 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 17250 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 17251 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 17252 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 17253 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 17254 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 17255 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 17256 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 17257 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 17258 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 17259 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 17260 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 17261 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 17262 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 17263 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 17264 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 17265 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 17266 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 17267 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 17268 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 17269 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 17270 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 17271 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 17272 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 17273 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 17274 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 17275 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 17276 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 17277 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 17278 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 17279 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 17280 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 17281 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 17282 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 17283 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 17284 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 17285 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 17286 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 17287 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 17288 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 17289 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 17290 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 17291 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 17292 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 17293 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 17294 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 17295 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 17296 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 17297 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 17298 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 17299 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 17300 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 17301 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 17302 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 17303 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 17304 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 17305 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 17306 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 17307 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 17308 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 17309 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 17310 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 17311 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 17312 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 17313 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 17314 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 17315 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 17316 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 17317 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 17318 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 17319 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 17320 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 17321 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 17322 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 17323 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 17324 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 17325 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 17326 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 17327 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 17328 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 17329 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 17330 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 17331 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 17332 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 17333 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 17334 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 17335 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 17336 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 17337 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 17338 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 17339 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 17340 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 17341 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 17342 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 17343 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 17344 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 17345 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 17346 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 17347 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 17348 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 17349 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 17350 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 17351 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 17352 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 17353 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 17354 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 17355 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 17356 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 17357 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 17358 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 17359 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 17360 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 17361 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 17362 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 17363 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 17364 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 17365 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 17366 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 17367 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 17368 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 17369 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 17370 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 17371 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 17372 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 17373 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 17374 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 17375 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 17376 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 17377 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 17378 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 17379 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 17380 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 17381 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 17382 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 17383 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 17384 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 17385 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 17386 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 17387 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 17388 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 17389 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 17390 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 17391 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 17392 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 17393 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 17394 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 17395 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 17396 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 17397 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 17398 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 17399 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 17400 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 17401 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 17402 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 17403 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 17404 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 17405 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 17406 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 17407 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 17408 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 17409 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 17410 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 17411 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 17412 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 17413 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 17414 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 17415 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 17416 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 17417 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 17418 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 17419 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 17420 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 17421 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 17422 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 17423 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 17424 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 17425 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 17426 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 17427 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 17428 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 17429 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 17430 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 17431 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 17432 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 17433 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 17434 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 17435 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 17436 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 17437 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 17438 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 17439 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 17440 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 17441 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 17442 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 17443 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 17444 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 17445 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 17446 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 17447 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 17448 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 17449 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 17450 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 17451 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 17452 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 17453 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 17454 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 17455 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 17456 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 17457 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 17458 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 17459 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 17460 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 17461 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 17462 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 17463 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 17464 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 17465 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 17466 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 17467 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 17468 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 17469 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 17470 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 17471 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 17472 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 17473 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 17474 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 17475 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 17476 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 17477 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 17478 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 17479 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 17480 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 17481 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 17482 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 17483 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 17484 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 17485 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 17486 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 17487 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 17488 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 17489 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 17490 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 17491 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 17492 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 17493 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 17494 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 17495 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 17496 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 17497 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 17498 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 17499 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 17500 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 17501 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 17502 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 17503 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 17504 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 17505 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 17506 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 17507 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 17508 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 17509 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 17510 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 17511 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 17512 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 17513 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 17514 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 17515 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 17516 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 17517 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 17518 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 17519 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 17520 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 17521 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 17522 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 17523 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 17524 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 17525 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 17526 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 17527 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 17528 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 17529 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 17530 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 17531 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 17532 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 17533 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 17534 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 17535 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 17536 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 17537 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 17538 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 17539 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 17540 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 17541 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 17542 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 17543 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 17544 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 17545 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 17546 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 17547 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 17548 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 17549 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 17550 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 17551 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 17552 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 17553 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 17554 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 17555 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 17556 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 17557 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 17558 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 17559 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 17560 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 17561 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 17562 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 17563 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 17564 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 17565 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 17566 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 17567 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 17568 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 17569 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 17570 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 17571 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 17572 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 17573 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 17574 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 17575 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 17576 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 17577 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 17578 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 17579 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 17580 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 17581 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 17582 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 17583 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 17584 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 17585 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 17586 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 17587 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 17588 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 17589 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 17590 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 17591 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 17592 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 17593 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 17594 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 17595 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 17596 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 17597 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 17598 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 17599 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 17600 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 17601 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 17602 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 17603 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 17604 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 17605 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 17606 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 17607 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 17608 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 17609 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 17610 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 17611 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 17612 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 17613 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 17614 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 17615 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 17616 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 17617 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 17618 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 17619 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 17620 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 17621 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 17622 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 17623 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 17624 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 17625 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 17626 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 17627 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 17628 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 17629 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 17630 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 17631 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 17632 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 17633 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 17634 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 17635 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 17636 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 17637 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 17638 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 17639 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 17640 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 17641 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 17642 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 17643 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 17644 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 17645 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 17646 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 17647 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 17648 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 17649 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 17650 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 17651 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 17652 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 17653 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 17654 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 17655 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 17656 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 17657 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 17658 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 17659 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 17660 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 17661 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 17662 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 17663 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 17664 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 17665 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 17666 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 17667 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 17668 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 17669 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 17670 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 17671 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 17672 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 17673 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 17674 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 17675 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 17676 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 17677 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 17678 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 17679 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 17680 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 17681 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 17682 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 17683 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 17684 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 17685 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 17686 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 17687 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 17688 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 17689 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 17690 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 17691 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 17692 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 17693 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 17694 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 17695 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 17696 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 17697 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 17698 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 17699 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 17700 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 17701 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 17702 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 17703 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 17704 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 17705 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 17706 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 17707 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 17708 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 17709 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 17710 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 17711 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 17712 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 17713 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 17714 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 17715 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 17716 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 17717 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 17718 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 17719 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 17720 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 17721 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 17722 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 17723 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 17724 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 17725 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 17726 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 17727 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 17728 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 17729 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 17730 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 17731 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 17732 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 17733 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 17734 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 17735 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 17736 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 17737 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 17738 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 17739 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 17740 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 17741 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 17742 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 17743 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 17744 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 17745 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 17746 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 17747 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 17748 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 17749 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 17750 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 17751 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 17752 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 17753 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 17754 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 17755 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 17756 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 17757 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 17758 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 17759 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 17760 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 17761 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 17762 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 17763 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 17764 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 17765 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 17766 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 17767 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 17768 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 17769 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 17770 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 17771 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 17772 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 17773 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 17774 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 17775 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 17776 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 17777 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 17778 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 17779 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 17780 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 17781 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 17782 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 17783 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 17784 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 17785 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 17786 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 17787 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 17788 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 17789 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 17790 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 17791 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 17792 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 17793 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 17794 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 17795 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 17796 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 17797 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 17798 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 17799 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 17800 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 17801 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 17802 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 17803 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 17804 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 17805 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 17806 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 17807 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 17808 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 17809 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 17810 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 17811 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 17812 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 17813 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 17814 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 17815 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 17816 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 17817 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 17818 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 17819 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 17820 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 17821 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 17822 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 17823 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 17824 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 17825 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 17826 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 17827 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 17828 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 17829 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 17830 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 17831 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 17832 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 17833 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 17834 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 17835 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 17836 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 17837 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 17838 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 17839 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 17840 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 17841 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 17842 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 17843 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 17844 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 17845 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 17846 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 17847 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 17848 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 17849 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 17850 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 17851 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 17852 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 17853 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 17854 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 17855 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 17856 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 17857 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 17858 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 17859 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 17860 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 17861 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 17862 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 17863 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 17864 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 17865 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 17866 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 17867 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 17868 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 17869 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 17870 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 17871 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 17872 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 17873 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 17874 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 17875 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 17876 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 17877 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 17878 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 17879 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 17880 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 17881 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 17882 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 17883 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 17884 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 17885 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 17886 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 17887 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 17888 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 17889 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 17890 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 17891 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 17892 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 17893 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 17894 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 17895 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 17896 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 17897 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 17898 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 17899 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 17900 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 17901 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 17902 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 17903 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 17904 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 17905 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 17906 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 17907 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 17908 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 17909 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 17910 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 17911 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 17912 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 17913 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 17914 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 17915 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 17916 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 17917 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 17918 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 17919 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 17920 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 17921 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 17922 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 17923 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 17924 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 17925 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 17926 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 17927 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 17928 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 17929 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 17930 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 17931 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 17932 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 17933 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 17934 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 17935 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 17936 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 17937 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 17938 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 17939 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 17940 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 17941 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 17942 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 17943 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 17944 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 17945 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 17946 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 17947 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 17948 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 17949 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 17950 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 17951 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 17952 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 17953 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 17954 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 17955 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 17956 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 17957 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 17958 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 17959 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 17960 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 17961 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 17962 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 17963 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 17964 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 17965 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 17966 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 17967 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 17968 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 17969 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 17970 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 17971 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 17972 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 17973 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 17974 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 17975 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 17976 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 17977 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 17978 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 17979 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 17980 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 17981 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 17982 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 17983 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 17984 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 17985 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 17986 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 17987 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 17988 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 17989 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 17990 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 17991 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 17992 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 17993 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 17994 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 17995 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 17996 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 17997 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 17998 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 17999 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 18000 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 18001 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 18002 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 18003 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 18004 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 18005 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 18006 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 18007 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 18008 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 18009 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 18010 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 18011 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 18012 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 18013 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 18014 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 18015 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 18016 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 18017 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 18018 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 18019 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 18020 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 18021 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 18022 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 18023 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 18024 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 18025 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 18026 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 18027 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 18028 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 18029 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 18030 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 18031 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 18032 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 18033 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 18034 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 18035 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 18036 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 18037 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 18038 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 18039 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 18040 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 18041 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 18042 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 18043 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 18044 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 18045 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 18046 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 18047 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 18048 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 18049 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 18050 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 18051 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 18052 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 18053 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 18054 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 18055 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 18056 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 18057 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 18058 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 18059 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 18060 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 18061 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 18062 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 18063 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 18064 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 18065 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 18066 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 18067 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 18068 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 18069 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 18070 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 18071 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 18072 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 18073 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 18074 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 18075 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 18076 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 18077 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 18078 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 18079 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 18080 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 18081 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 18082 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 18083 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 18084 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 18085 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 18086 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 18087 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 18088 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 18089 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 18090 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 18091 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 18092 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 18093 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 18094 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 18095 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 18096 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 18097 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 18098 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 18099 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 18100 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 18101 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 18102 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 18103 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 18104 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 18105 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 18106 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 18107 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 18108 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 18109 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 18110 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 18111 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 18112 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 18113 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 18114 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 18115 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 18116 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 18117 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 18118 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 18119 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 18120 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 18121 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 18122 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 18123 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 18124 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 18125 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 18126 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 18127 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 18128 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 18129 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 18130 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 18131 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 18132 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 18133 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 18134 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 18135 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 18136 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 18137 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 18138 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 18139 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 18140 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 18141 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 18142 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 18143 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 18144 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 18145 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 18146 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 18147 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 18148 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 18149 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 18150 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 18151 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 18152 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 18153 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 18154 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 18155 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 18156 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 18157 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 18158 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 18159 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 18160 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 18161 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 18162 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 18163 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 18164 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 18165 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 18166 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 18167 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 18168 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 18169 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 18170 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 18171 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 18172 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 18173 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 18174 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 18175 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 18176 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 18177 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 18178 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 18179 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 18180 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 18181 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 18182 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 18183 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 18184 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 18185 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 18186 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 18187 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 18188 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 18189 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 18190 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 18191 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 18192 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 18193 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 18194 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 18195 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 18196 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 18197 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 18198 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 18199 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 18200 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 18201 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 18202 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 18203 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 18204 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 18205 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 18206 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 18207 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 18208 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 18209 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 18210 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 18211 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 18212 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 18213 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 18214 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 18215 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 18216 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 18217 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 18218 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 18219 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 18220 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 18221 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 18222 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 18223 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 18224 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 18225 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 18226 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 18227 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 18228 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 18229 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 18230 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 18231 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 18232 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 18233 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 18234 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 18235 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 18236 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 18237 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 18238 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 18239 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 18240 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 18241 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 18242 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 18243 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 18244 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 18245 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 18246 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 18247 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 18248 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 18249 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 18250 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 18251 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 18252 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 18253 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 18254 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 18255 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 18256 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 18257 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 18258 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 18259 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 18260 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 18261 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 18262 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 18263 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 18264 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 18265 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 18266 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 18267 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 18268 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 18269 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 18270 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 18271 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 18272 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 18273 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 18274 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 18275 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 18276 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 18277 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 18278 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 18279 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 18280 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 18281 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 18282 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 18283 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 18284 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 18285 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 18286 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 18287 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 18288 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 18289 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 18290 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 18291 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 18292 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 18293 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 18294 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 18295 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 18296 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 18297 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 18298 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 18299 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 18300 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 18301 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 18302 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 18303 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 18304 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 18305 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 18306 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 18307 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 18308 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 18309 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 18310 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 18311 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 18312 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 18313 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 18314 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 18315 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 18316 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 18317 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 18318 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 18319 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 18320 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 18321 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 18322 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 18323 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 18324 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 18325 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 18326 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 18327 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 18328 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 18329 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 18330 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 18331 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 18332 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 18333 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 18334 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 18335 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 18336 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 18337 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 18338 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 18339 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 18340 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 18341 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 18342 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 18343 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 18344 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 18345 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 18346 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 18347 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 18348 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 18349 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 18350 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 18351 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 18352 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 18353 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 18354 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 18355 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 18356 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 18357 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 18358 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 18359 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 18360 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 18361 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 18362 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 18363 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 18364 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 18365 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 18366 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 18367 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 18368 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 18369 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 18370 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 18371 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 18372 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 18373 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 18374 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 18375 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 18376 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 18377 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 18378 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 18379 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 18380 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 18381 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 18382 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 18383 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 18384 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 18385 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 18386 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 18387 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 18388 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 18389 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 18390 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 18391 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 18392 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 18393 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 18394 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 18395 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 18396 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 18397 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 18398 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 18399 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 18400 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 18401 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 18402 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 18403 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 18404 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 18405 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 18406 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 18407 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 18408 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 18409 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 18410 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 18411 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 18412 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 18413 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 18414 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 18415 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 18416 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 18417 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 18418 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 18419 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 18420 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 18421 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 18422 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 18423 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 18424 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 18425 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 18426 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 18427 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 18428 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 18429 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 18430 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 18431 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 18432 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 18433 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 18434 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 18435 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 18436 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 18437 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 18438 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 18439 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 18440 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 18441 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 18442 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 18443 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 18444 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 18445 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 18446 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 18447 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 18448 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 18449 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 18450 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 18451 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 18452 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 18453 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 18454 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 18455 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 18456 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 18457 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 18458 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 18459 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 18460 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 18461 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 18462 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 18463 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 18464 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 18465 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 18466 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 18467 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 18468 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 18469 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 18470 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 18471 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 18472 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 18473 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 18474 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 18475 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 18476 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 18477 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 18478 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 18479 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 18480 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 18481 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 18482 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 18483 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 18484 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 18485 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 18486 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 18487 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 18488 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 18489 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 18490 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 18491 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 18492 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 18493 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 18494 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 18495 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 18496 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 18497 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 18498 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 18499 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 18500 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 18501 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 18502 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 18503 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 18504 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 18505 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 18506 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 18507 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 18508 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 18509 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 18510 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 18511 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 18512 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 18513 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 18514 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 18515 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 18516 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 18517 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 18518 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 18519 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 18520 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 18521 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 18522 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 18523 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 18524 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 18525 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 18526 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 18527 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 18528 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 18529 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 18530 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 18531 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 18532 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 18533 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 18534 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 18535 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 18536 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 18537 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 18538 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 18539 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 18540 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 18541 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 18542 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 18543 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 18544 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 18545 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 18546 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 18547 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 18548 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 18549 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 18550 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 18551 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 18552 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 18553 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 18554 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 18555 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 18556 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 18557 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 18558 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 18559 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 18560 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 18561 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 18562 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 18563 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 18564 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 18565 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 18566 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 18567 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 18568 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 18569 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 18570 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 18571 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 18572 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 18573 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 18574 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 18575 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 18576 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 18577 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 18578 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 18579 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 18580 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 18581 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 18582 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 18583 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 18584 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 18585 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 18586 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 18587 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 18588 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 18589 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 18590 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 18591 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 18592 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 18593 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 18594 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 18595 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 18596 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 18597 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 18598 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 18599 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 18600 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 18601 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 18602 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 18603 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 18604 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 18605 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 18606 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 18607 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 18608 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 18609 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 18610 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 18611 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 18612 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 18613 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 18614 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 18615 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 18616 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 18617 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 18618 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 18619 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 18620 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 18621 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 18622 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 18623 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 18624 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 18625 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 18626 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 18627 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 18628 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 18629 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 18630 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 18631 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 18632 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 18633 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 18634 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 18635 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 18636 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 18637 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 18638 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 18639 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 18640 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 18641 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 18642 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 18643 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 18644 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 18645 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 18646 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 18647 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 18648 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 18649 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 18650 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 18651 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 18652 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 18653 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 18654 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 18655 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 18656 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 18657 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 18658 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 18659 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 18660 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 18661 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 18662 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 18663 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 18664 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 18665 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 18666 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 18667 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 18668 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 18669 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 18670 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 18671 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 18672 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 18673 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 18674 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 18675 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 18676 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 18677 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 18678 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 18679 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 18680 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 18681 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 18682 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 18683 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 18684 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 18685 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 18686 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 18687 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 18688 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 18689 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 18690 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 18691 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 18692 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 18693 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 18694 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 18695 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 18696 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 18697 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 18698 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 18699 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 18700 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 18701 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 18702 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 18703 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 18704 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 18705 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 18706 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 18707 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 18708 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 18709 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 18710 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 18711 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 18712 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 18713 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 18714 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 18715 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 18716 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 18717 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 18718 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 18719 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 18720 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 18721 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 18722 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 18723 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 18724 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 18725 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 18726 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 18727 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 18728 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 18729 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 18730 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 18731 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 18732 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 18733 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 18734 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 18735 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 18736 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 18737 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 18738 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 18739 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 18740 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 18741 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 18742 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 18743 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 18744 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 18745 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 18746 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 18747 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 18748 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 18749 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 18750 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 18751 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 18752 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 18753 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 18754 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 18755 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 18756 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 18757 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 18758 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 18759 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 18760 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 18761 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 18762 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 18763 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 18764 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 18765 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 18766 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 18767 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 18768 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 18769 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 18770 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 18771 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 18772 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 18773 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 18774 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 18775 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 18776 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 18777 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 18778 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 18779 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 18780 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 18781 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 18782 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 18783 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 18784 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 18785 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 18786 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 18787 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 18788 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 18789 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 18790 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 18791 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 18792 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 18793 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 18794 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 18795 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 18796 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 18797 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 18798 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 18799 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 18800 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 18801 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 18802 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 18803 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 18804 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 18805 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 18806 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 18807 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 18808 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 18809 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 18810 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 18811 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 18812 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 18813 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 18814 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 18815 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 18816 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 18817 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 18818 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 18819 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 18820 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 18821 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 18822 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 18823 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 18824 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 18825 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 18826 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 18827 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 18828 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 18829 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 18830 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 18831 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 18832 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 18833 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 18834 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 18835 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 18836 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 18837 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 18838 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 18839 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 18840 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 18841 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 18842 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 18843 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 18844 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 18845 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 18846 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 18847 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 18848 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 18849 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 18850 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 18851 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 18852 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 18853 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 18854 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 18855 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 18856 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 18857 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 18858 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 18859 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 18860 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 18861 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 18862 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 18863 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 18864 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 18865 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 18866 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 18867 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 18868 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 18869 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 18870 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 18871 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 18872 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 18873 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 18874 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 18875 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 18876 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 18877 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 18878 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 18879 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 18880 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 18881 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 18882 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 18883 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 18884 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 18885 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 18886 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 18887 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 18888 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 18889 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 18890 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 18891 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 18892 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 18893 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 18894 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 18895 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 18896 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 18897 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 18898 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 18899 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 18900 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 18901 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 18902 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 18903 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 18904 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 18905 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 18906 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 18907 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 18908 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 18909 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 18910 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 18911 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 18912 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 18913 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 18914 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 18915 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 18916 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 18917 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 18918 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 18919 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 18920 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 18921 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 18922 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 18923 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 18924 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 18925 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 18926 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 18927 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 18928 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 18929 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 18930 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 18931 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 18932 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 18933 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 18934 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 18935 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 18936 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 18937 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 18938 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 18939 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 18940 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 18941 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 18942 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 18943 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 18944 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 18945 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 18946 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 18947 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 18948 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 18949 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 18950 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 18951 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 18952 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 18953 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 18954 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 18955 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 18956 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 18957 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 18958 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 18959 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 18960 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 18961 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 18962 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 18963 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 18964 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 18965 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 18966 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 18967 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 18968 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 18969 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 18970 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 18971 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 18972 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 18973 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 18974 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 18975 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 18976 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 18977 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 18978 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 18979 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 18980 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 18981 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 18982 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 18983 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 18984 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 18985 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 18986 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 18987 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 18988 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 18989 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 18990 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 18991 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 18992 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 18993 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 18994 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 18995 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 18996 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 18997 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 18998 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 18999 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 19000 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 19001 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 19002 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 19003 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 19004 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 19005 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 19006 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 19007 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 19008 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 19009 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 19010 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 19011 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 19012 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 19013 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 19014 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 19015 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 19016 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 19017 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 19018 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 19019 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 19020 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 19021 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 19022 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 19023 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 19024 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 19025 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 19026 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 19027 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 19028 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 19029 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 19030 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 19031 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 19032 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 19033 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 19034 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 19035 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 19036 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 19037 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 19038 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 19039 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 19040 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 19041 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 19042 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 19043 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 19044 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 19045 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 19046 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 19047 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 19048 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 19049 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 19050 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 19051 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 19052 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 19053 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 19054 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 19055 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 19056 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 19057 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 19058 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 19059 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 19060 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 19061 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 19062 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 19063 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 19064 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 19065 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 19066 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 19067 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 19068 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 19069 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 19070 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 19071 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 19072 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 19073 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 19074 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 19075 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 19076 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 19077 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 19078 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 19079 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 19080 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 19081 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 19082 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 19083 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 19084 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 19085 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 19086 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 19087 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 19088 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 19089 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 19090 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 19091 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 19092 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 19093 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 19094 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 19095 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 19096 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 19097 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 19098 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 19099 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 19100 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 19101 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 19102 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 19103 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 19104 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 19105 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 19106 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 19107 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 19108 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 19109 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 19110 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 19111 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 19112 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 19113 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 19114 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 19115 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 19116 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 19117 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 19118 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 19119 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 19120 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 19121 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 19122 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 19123 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 19124 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 19125 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 19126 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 19127 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 19128 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 19129 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 19130 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 19131 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 19132 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 19133 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 19134 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 19135 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 19136 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 19137 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 19138 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 19139 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 19140 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 19141 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 19142 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 19143 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 19144 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 19145 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 19146 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 19147 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 19148 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 19149 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 19150 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 19151 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 19152 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 19153 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 19154 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 19155 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 19156 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 19157 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 19158 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 19159 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 19160 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 19161 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 19162 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 19163 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 19164 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 19165 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 19166 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 19167 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 19168 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 19169 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 19170 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 19171 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 19172 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 19173 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 19174 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 19175 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 19176 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 19177 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 19178 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 19179 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 19180 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 19181 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 19182 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 19183 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 19184 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 19185 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 19186 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 19187 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 19188 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 19189 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 19190 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 19191 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 19192 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 19193 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 19194 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 19195 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 19196 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 19197 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 19198 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 19199 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 19200 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 19201 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 19202 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 19203 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 19204 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 19205 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 19206 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 19207 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 19208 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 19209 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 19210 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 19211 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 19212 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 19213 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 19214 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 19215 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 19216 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 19217 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 19218 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 19219 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 19220 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 19221 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 19222 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 19223 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 19224 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 19225 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 19226 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 19227 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 19228 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 19229 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 19230 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 19231 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 19232 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 19233 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 19234 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 19235 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 19236 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 19237 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 19238 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 19239 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 19240 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 19241 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 19242 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 19243 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 19244 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 19245 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 19246 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 19247 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 19248 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 19249 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 19250 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 19251 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 19252 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 19253 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 19254 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 19255 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 19256 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 19257 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 19258 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 19259 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 19260 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 19261 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 19262 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 19263 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 19264 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 19265 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 19266 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 19267 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 19268 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 19269 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 19270 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 19271 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 19272 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 19273 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 19274 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 19275 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 19276 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 19277 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 19278 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 19279 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 19280 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 19281 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 19282 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 19283 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 19284 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 19285 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 19286 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 19287 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 19288 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 19289 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 19290 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 19291 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 19292 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 19293 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 19294 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 19295 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 19296 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 19297 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 19298 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 19299 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 19300 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 19301 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 19302 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 19303 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 19304 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 19305 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 19306 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 19307 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 19308 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 19309 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 19310 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 19311 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 19312 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 19313 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 19314 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 19315 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 19316 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 19317 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 19318 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 19319 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 19320 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 19321 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 19322 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 19323 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 19324 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 19325 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 19326 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 19327 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 19328 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 19329 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 19330 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 19331 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 19332 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 19333 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 19334 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 19335 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 19336 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 19337 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 19338 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 19339 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 19340 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 19341 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 19342 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 19343 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 19344 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 19345 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 19346 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 19347 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 19348 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 19349 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 19350 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 19351 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 19352 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 19353 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 19354 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 19355 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 19356 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 19357 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 19358 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 19359 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 19360 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 19361 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 19362 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 19363 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 19364 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 19365 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 19366 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 19367 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 19368 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 19369 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 19370 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 19371 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 19372 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 19373 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 19374 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 19375 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 19376 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 19377 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 19378 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 19379 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 19380 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 19381 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 19382 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 19383 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 19384 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 19385 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 19386 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 19387 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 19388 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 19389 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 19390 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 19391 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 19392 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 19393 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 19394 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 19395 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 19396 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 19397 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 19398 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 19399 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 19400 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 19401 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 19402 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 19403 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 19404 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 19405 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 19406 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 19407 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 19408 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 19409 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 19410 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 19411 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 19412 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 19413 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 19414 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 19415 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 19416 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 19417 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 19418 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 19419 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 19420 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 19421 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 19422 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 19423 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 19424 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 19425 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 19426 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 19427 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 19428 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 19429 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 19430 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 19431 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 19432 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 19433 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 19434 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 19435 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 19436 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 19437 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 19438 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 19439 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 19440 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 19441 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 19442 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 19443 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 19444 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 19445 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 19446 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 19447 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 19448 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 19449 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 19450 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 19451 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 19452 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 19453 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 19454 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 19455 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 19456 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 19457 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 19458 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 19459 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 19460 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 19461 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 19462 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 19463 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 19464 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 19465 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 19466 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 19467 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 19468 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 19469 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 19470 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 19471 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 19472 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 19473 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 19474 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 19475 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 19476 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 19477 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 19478 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 19479 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 19480 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 19481 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 19482 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 19483 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 19484 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 19485 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 19486 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 19487 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 19488 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 19489 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 19490 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 19491 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 19492 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 19493 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 19494 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 19495 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 19496 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 19497 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 19498 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 19499 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 19500 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 19501 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 19502 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 19503 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 19504 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 19505 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 19506 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 19507 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 19508 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 19509 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 19510 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 19511 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 19512 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 19513 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 19514 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 19515 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 19516 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 19517 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 19518 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 19519 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 19520 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 19521 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 19522 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 19523 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 19524 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 19525 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 19526 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 19527 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 19528 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 19529 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 19530 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 19531 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 19532 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 19533 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 19534 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 19535 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 19536 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 19537 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 19538 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 19539 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 19540 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 19541 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 19542 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 19543 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 19544 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 19545 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 19546 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 19547 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 19548 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 19549 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 19550 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 19551 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 19552 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 19553 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 19554 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 19555 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 19556 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 19557 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 19558 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 19559 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 19560 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 19561 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 19562 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 19563 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 19564 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 19565 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 19566 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 19567 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 19568 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 19569 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 19570 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 19571 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 19572 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 19573 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 19574 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 19575 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 19576 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 19577 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 19578 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 19579 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 19580 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 19581 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 19582 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 19583 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 19584 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 19585 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 19586 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 19587 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 19588 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 19589 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 19590 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 19591 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 19592 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 19593 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 19594 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 19595 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 19596 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 19597 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 19598 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 19599 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 19600 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 19601 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 19602 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 19603 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 19604 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 19605 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 19606 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 19607 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 19608 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 19609 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 19610 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 19611 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 19612 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 19613 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 19614 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 19615 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 19616 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 19617 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 19618 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 19619 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 19620 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 19621 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 19622 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 19623 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 19624 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 19625 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 19626 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 19627 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 19628 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 19629 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 19630 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 19631 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 19632 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 19633 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 19634 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 19635 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 19636 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 19637 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 19638 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 19639 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 19640 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 19641 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 19642 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 19643 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 19644 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 19645 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 19646 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 19647 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 19648 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 19649 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 19650 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 19651 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 19652 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 19653 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 19654 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 19655 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 19656 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 19657 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 19658 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 19659 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 19660 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 19661 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 19662 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 19663 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 19664 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 19665 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 19666 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 19667 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 19668 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 19669 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 19670 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 19671 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 19672 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 19673 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 19674 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 19675 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 19676 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 19677 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 19678 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 19679 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 19680 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 19681 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 19682 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 19683 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 19684 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 19685 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 19686 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 19687 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 19688 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 19689 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 19690 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 19691 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 19692 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 19693 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 19694 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 19695 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 19696 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 19697 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 19698 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 19699 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 19700 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 19701 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 19702 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 19703 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 19704 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 19705 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 19706 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 19707 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 19708 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 19709 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 19710 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 19711 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 19712 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 19713 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 19714 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 19715 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 19716 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 19717 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 19718 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 19719 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 19720 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 19721 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 19722 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 19723 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 19724 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 19725 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 19726 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 19727 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 19728 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 19729 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 19730 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 19731 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 19732 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 19733 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 19734 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 19735 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 19736 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 19737 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 19738 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 19739 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 19740 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 19741 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 19742 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 19743 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 19744 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 19745 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 19746 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 19747 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 19748 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 19749 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 19750 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 19751 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 19752 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 19753 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 19754 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 19755 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 19756 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 19757 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 19758 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 19759 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 19760 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 19761 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 19762 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 19763 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 19764 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 19765 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 19766 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 19767 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 19768 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 19769 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 19770 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 19771 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 19772 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 19773 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 19774 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 19775 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 19776 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 19777 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 19778 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 19779 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 19780 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 19781 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 19782 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 19783 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 19784 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 19785 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 19786 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 19787 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 19788 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 19789 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 19790 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 19791 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 19792 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 19793 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 19794 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 19795 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 19796 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 19797 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 19798 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 19799 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 19800 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 19801 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 19802 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 19803 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 19804 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 19805 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 19806 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 19807 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 19808 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 19809 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 19810 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 19811 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 19812 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 19813 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 19814 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 19815 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 19816 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 19817 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 19818 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 19819 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 19820 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 19821 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 19822 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 19823 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 19824 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 19825 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 19826 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 19827 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 19828 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 19829 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 19830 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 19831 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 19832 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 19833 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 19834 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 19835 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 19836 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 19837 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 19838 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 19839 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 19840 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 19841 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 19842 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 19843 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 19844 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 19845 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 19846 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 19847 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 19848 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 19849 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 19850 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 19851 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 19852 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 19853 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 19854 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 19855 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 19856 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 19857 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 19858 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 19859 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 19860 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 19861 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 19862 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 19863 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 19864 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 19865 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 19866 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 19867 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 19868 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 19869 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 19870 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 19871 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 19872 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 19873 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 19874 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 19875 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 19876 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 19877 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 19878 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 19879 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 19880 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 19881 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 19882 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 19883 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 19884 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 19885 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 19886 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 19887 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 19888 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 19889 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 19890 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 19891 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 19892 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 19893 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 19894 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 19895 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 19896 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 19897 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 19898 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 19899 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 19900 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 19901 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 19902 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 19903 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 19904 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 19905 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 19906 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 19907 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 19908 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 19909 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 19910 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 19911 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 19912 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 19913 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 19914 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 19915 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 19916 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 19917 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 19918 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 19919 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 19920 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 19921 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 19922 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 19923 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 19924 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 19925 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 19926 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 19927 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 19928 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 19929 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 19930 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 19931 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 19932 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 19933 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 19934 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 19935 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 19936 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 19937 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 19938 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 19939 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 19940 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 19941 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 19942 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 19943 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 19944 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 19945 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 19946 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 19947 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 19948 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 19949 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 19950 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 19951 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 19952 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 19953 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 19954 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 19955 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 19956 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 19957 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 19958 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 19959 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 19960 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 19961 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 19962 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 19963 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 19964 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 19965 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 19966 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 19967 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 19968 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 19969 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 19970 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 19971 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 19972 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 19973 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 19974 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 19975 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 19976 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 19977 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 19978 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 19979 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 19980 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 19981 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 19982 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 19983 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 19984 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 19985 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 19986 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 19987 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 19988 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 19989 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 19990 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 19991 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 19992 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 19993 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 19994 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 19995 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 19996 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 19997 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 19998 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 19999 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 20000 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 20001 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 20002 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 20003 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 20004 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 20005 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 20006 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 20007 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 20008 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 20009 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 20010 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 20011 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 20012 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 20013 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 20014 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 20015 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 20016 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 20017 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 20018 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 20019 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 20020 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 20021 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 20022 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 20023 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 20024 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 20025 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 20026 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 20027 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 20028 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 20029 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 20030 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 20031 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 20032 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 20033 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 20034 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 20035 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 20036 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 20037 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 20038 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 20039 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 20040 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 20041 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 20042 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 20043 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 20044 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 20045 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 20046 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 20047 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 20048 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 20049 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 20050 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 20051 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 20052 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 20053 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 20054 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 20055 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 20056 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 20057 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 20058 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 20059 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 20060 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 20061 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 20062 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 20063 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 20064 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 20065 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 20066 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 20067 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 20068 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 20069 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 20070 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 20071 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 20072 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 20073 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 20074 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 20075 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 20076 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 20077 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 20078 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 20079 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 20080 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 20081 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 20082 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 20083 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 20084 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 20085 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 20086 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 20087 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 20088 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 20089 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 20090 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 20091 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 20092 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 20093 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 20094 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 20095 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 20096 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 20097 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 20098 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 20099 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 20100 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 20101 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 20102 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 20103 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 20104 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 20105 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 20106 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 20107 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 20108 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 20109 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 20110 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 20111 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 20112 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 20113 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 20114 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 20115 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 20116 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 20117 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 20118 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 20119 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 20120 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 20121 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 20122 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 20123 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 20124 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 20125 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 20126 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 20127 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 20128 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 20129 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 20130 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 20131 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 20132 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 20133 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 20134 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 20135 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 20136 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 20137 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 20138 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 20139 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 20140 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 20141 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 20142 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 20143 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 20144 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 20145 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 20146 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 20147 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 20148 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 20149 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 20150 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 20151 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 20152 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 20153 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 20154 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 20155 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 20156 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 20157 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 20158 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 20159 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 20160 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 20161 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 20162 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 20163 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 20164 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 20165 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 20166 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 20167 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 20168 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 20169 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 20170 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 20171 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 20172 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 20173 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 20174 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 20175 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 20176 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 20177 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 20178 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 20179 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 20180 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 20181 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 20182 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 20183 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 20184 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 20185 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 20186 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 20187 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 20188 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 20189 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 20190 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 20191 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 20192 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 20193 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 20194 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 20195 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 20196 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 20197 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 20198 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 20199 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 20200 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 20201 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 20202 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 20203 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 20204 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 20205 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 20206 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 20207 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 20208 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 20209 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 20210 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 20211 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 20212 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 20213 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 20214 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 20215 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 20216 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 20217 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 20218 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 20219 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 20220 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 20221 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 20222 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 20223 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 20224 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 20225 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 20226 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 20227 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 20228 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 20229 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 20230 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 20231 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 20232 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 20233 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 20234 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 20235 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 20236 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 20237 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 20238 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 20239 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 20240 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 20241 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 20242 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 20243 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 20244 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 20245 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 20246 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 20247 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 20248 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 20249 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 20250 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 20251 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 20252 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 20253 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 20254 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 20255 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 20256 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 20257 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 20258 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 20259 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 20260 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 20261 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 20262 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 20263 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 20264 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 20265 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 20266 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 20267 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 20268 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 20269 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 20270 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 20271 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 20272 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 20273 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 20274 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 20275 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 20276 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 20277 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 20278 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 20279 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 20280 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 20281 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 20282 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 20283 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 20284 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 20285 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 20286 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 20287 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 20288 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 20289 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 20290 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 20291 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 20292 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 20293 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 20294 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 20295 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 20296 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 20297 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 20298 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 20299 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 20300 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 20301 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 20302 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 20303 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 20304 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 20305 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 20306 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 20307 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 20308 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 20309 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 20310 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 20311 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 20312 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 20313 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 20314 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 20315 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 20316 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 20317 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 20318 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 20319 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 20320 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 20321 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 20322 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 20323 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 20324 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 20325 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 20326 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 20327 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 20328 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 20329 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 20330 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 20331 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 20332 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 20333 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 20334 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 20335 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 20336 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 20337 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 20338 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 20339 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 20340 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 20341 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 20342 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 20343 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 20344 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 20345 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 20346 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 20347 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 20348 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 20349 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 20350 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 20351 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 20352 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 20353 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 20354 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 20355 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 20356 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 20357 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 20358 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 20359 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 20360 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 20361 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 20362 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 20363 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 20364 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 20365 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 20366 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 20367 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 20368 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 20369 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 20370 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 20371 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 20372 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 20373 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 20374 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 20375 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 20376 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 20377 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 20378 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 20379 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 20380 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 20381 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 20382 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 20383 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 20384 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 20385 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 20386 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 20387 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 20388 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 20389 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 20390 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 20391 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 20392 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 20393 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 20394 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 20395 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 20396 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 20397 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 20398 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 20399 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 20400 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 20401 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 20402 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 20403 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 20404 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 20405 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 20406 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 20407 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 20408 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 20409 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 20410 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 20411 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 20412 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 20413 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 20414 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 20415 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 20416 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 20417 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 20418 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 20419 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 20420 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 20421 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 20422 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 20423 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 20424 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 20425 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 20426 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 20427 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 20428 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 20429 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 20430 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 20431 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 20432 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 20433 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 20434 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 20435 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 20436 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 20437 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 20438 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 20439 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 20440 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 20441 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 20442 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 20443 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 20444 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 20445 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 20446 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 20447 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 20448 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 20449 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 20450 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 20451 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 20452 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 20453 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 20454 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 20455 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 20456 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 20457 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 20458 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 20459 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 20460 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 20461 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 20462 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 20463 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 20464 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 20465 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 20466 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 20467 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 20468 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 20469 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 20470 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 20471 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 20472 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 20473 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 20474 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 20475 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 20476 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 20477 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 20478 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 20479 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 20480 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 20481 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 20482 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 20483 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 20484 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 20485 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 20486 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 20487 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 20488 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 20489 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 20490 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 20491 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 20492 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 20493 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 20494 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 20495 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 20496 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 20497 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 20498 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 20499 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 20500 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 20501 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 20502 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 20503 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 20504 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 20505 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 20506 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 20507 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 20508 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 20509 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 20510 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 20511 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 20512 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 20513 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 20514 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 20515 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 20516 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 20517 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 20518 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 20519 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 20520 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 20521 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 20522 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 20523 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 20524 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 20525 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 20526 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 20527 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 20528 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 20529 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 20530 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 20531 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 20532 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 20533 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 20534 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 20535 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 20536 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 20537 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 20538 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 20539 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 20540 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 20541 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 20542 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 20543 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 20544 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 20545 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 20546 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 20547 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 20548 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 20549 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 20550 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 20551 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 20552 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 20553 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 20554 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 20555 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 20556 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 20557 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 20558 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 20559 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 20560 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 20561 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 20562 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 20563 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 20564 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 20565 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 20566 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 20567 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 20568 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 20569 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 20570 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 20571 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 20572 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 20573 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 20574 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 20575 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 20576 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 20577 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 20578 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 20579 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 20580 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 20581 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 20582 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 20583 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 20584 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 20585 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 20586 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 20587 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 20588 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 20589 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 20590 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 20591 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 20592 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 20593 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 20594 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 20595 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 20596 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 20597 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 20598 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 20599 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 20600 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 20601 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 20602 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 20603 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 20604 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 20605 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 20606 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 20607 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 20608 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 20609 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 20610 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 20611 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 20612 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 20613 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 20614 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 20615 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 20616 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 20617 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 20618 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 20619 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 20620 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 20621 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 20622 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 20623 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 20624 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 20625 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 20626 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 20627 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 20628 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 20629 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 20630 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 20631 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 20632 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 20633 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 20634 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 20635 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 20636 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 20637 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 20638 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 20639 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 20640 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 20641 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 20642 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 20643 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 20644 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 20645 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 20646 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 20647 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 20648 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 20649 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 20650 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 20651 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 20652 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 20653 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 20654 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 20655 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 20656 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 20657 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 20658 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 20659 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 20660 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 20661 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 20662 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 20663 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 20664 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 20665 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 20666 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 20667 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 20668 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 20669 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 20670 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 20671 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 20672 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 20673 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 20674 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 20675 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 20676 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 20677 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 20678 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 20679 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 20680 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 20681 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 20682 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 20683 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 20684 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 20685 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 20686 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 20687 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 20688 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 20689 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 20690 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 20691 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 20692 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 20693 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 20694 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 20695 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 20696 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 20697 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 20698 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 20699 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 20700 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 20701 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 20702 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 20703 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 20704 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 20705 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 20706 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 20707 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 20708 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 20709 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 20710 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 20711 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 20712 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 20713 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 20714 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 20715 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 20716 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 20717 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 20718 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 20719 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 20720 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 20721 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 20722 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 20723 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 20724 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 20725 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 20726 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 20727 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 20728 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 20729 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 20730 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 20731 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 20732 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 20733 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 20734 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 20735 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 20736 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 20737 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 20738 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 20739 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 20740 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 20741 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 20742 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 20743 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 20744 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 20745 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 20746 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 20747 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 20748 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 20749 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 20750 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 20751 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 20752 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 20753 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 20754 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 20755 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 20756 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 20757 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 20758 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 20759 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 20760 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 20761 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 20762 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 20763 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 20764 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 20765 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 20766 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 20767 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 20768 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 20769 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 20770 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 20771 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 20772 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 20773 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 20774 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 20775 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 20776 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 20777 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 20778 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 20779 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 20780 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 20781 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 20782 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 20783 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 20784 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 20785 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 20786 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 20787 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 20788 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 20789 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 20790 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 20791 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 20792 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 20793 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 20794 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 20795 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 20796 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 20797 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 20798 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 20799 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 20800 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 20801 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 20802 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 20803 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 20804 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 20805 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 20806 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 20807 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 20808 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 20809 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 20810 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 20811 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 20812 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 20813 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 20814 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 20815 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 20816 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 20817 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 20818 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 20819 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 20820 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 20821 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 20822 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 20823 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 20824 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 20825 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 20826 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 20827 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 20828 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 20829 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 20830 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 20831 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 20832 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 20833 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 20834 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 20835 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 20836 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 20837 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 20838 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 20839 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 20840 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 20841 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 20842 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 20843 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 20844 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 20845 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 20846 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 20847 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 20848 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 20849 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 20850 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 20851 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 20852 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 20853 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 20854 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 20855 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 20856 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 20857 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 20858 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 20859 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 20860 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 20861 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 20862 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 20863 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 20864 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 20865 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 20866 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 20867 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 20868 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 20869 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 20870 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 20871 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 20872 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 20873 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 20874 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 20875 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 20876 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 20877 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 20878 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 20879 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 20880 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 20881 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 20882 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 20883 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 20884 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 20885 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 20886 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 20887 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 20888 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 20889 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 20890 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 20891 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 20892 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 20893 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 20894 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 20895 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 20896 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 20897 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 20898 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 20899 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 20900 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 20901 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 20902 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 20903 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 20904 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 20905 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 20906 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 20907 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 20908 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 20909 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 20910 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 20911 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 20912 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 20913 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 20914 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 20915 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 20916 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 20917 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 20918 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 20919 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 20920 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 20921 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 20922 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 20923 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 20924 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 20925 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 20926 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 20927 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 20928 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 20929 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 20930 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 20931 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 20932 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 20933 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 20934 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 20935 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 20936 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 20937 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 20938 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 20939 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 20940 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 20941 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 20942 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 20943 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 20944 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 20945 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 20946 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 20947 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 20948 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 20949 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 20950 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 20951 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 20952 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 20953 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 20954 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 20955 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 20956 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 20957 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 20958 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 20959 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 20960 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 20961 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 20962 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 20963 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 20964 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 20965 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 20966 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 20967 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 20968 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 20969 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 20970 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 20971 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 20972 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 20973 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 20974 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 20975 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 20976 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 20977 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 20978 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 20979 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 20980 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 20981 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 20982 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 20983 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 20984 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 20985 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 20986 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 20987 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 20988 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 20989 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 20990 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 20991 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 20992 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 20993 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 20994 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 20995 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 20996 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 20997 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 20998 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 20999 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 21000 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 21001 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 21002 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 21003 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 21004 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 21005 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 21006 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 21007 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 21008 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 21009 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 21010 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 21011 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 21012 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 21013 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 21014 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 21015 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 21016 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 21017 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 21018 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 21019 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 21020 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 21021 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 21022 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 21023 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 21024 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 21025 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 21026 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 21027 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 21028 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 21029 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 21030 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 21031 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 21032 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 21033 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 21034 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 21035 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 21036 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 21037 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 21038 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 21039 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 21040 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 21041 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 21042 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 21043 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 21044 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 21045 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 21046 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 21047 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 21048 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 21049 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 21050 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 21051 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 21052 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 21053 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 21054 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 21055 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 21056 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 21057 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 21058 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 21059 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 21060 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 21061 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 21062 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 21063 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 21064 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 21065 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 21066 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 21067 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 21068 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 21069 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 21070 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 21071 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 21072 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 21073 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 21074 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 21075 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 21076 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 21077 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 21078 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 21079 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 21080 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 21081 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 21082 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 21083 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 21084 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 21085 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 21086 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 21087 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 21088 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 21089 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 21090 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 21091 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 21092 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 21093 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 21094 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 21095 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 21096 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 21097 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 21098 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 21099 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 21100 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 21101 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 21102 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 21103 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 21104 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 21105 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 21106 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 21107 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 21108 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 21109 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 21110 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 21111 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 21112 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 21113 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 21114 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 21115 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 21116 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 21117 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 21118 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 21119 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 21120 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 21121 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 21122 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 21123 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 21124 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 21125 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 21126 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 21127 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 21128 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 21129 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 21130 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 21131 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 21132 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 21133 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 21134 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 21135 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 21136 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 21137 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 21138 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 21139 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 21140 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 21141 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 21142 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 21143 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 21144 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 21145 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 21146 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 21147 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 21148 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 21149 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 21150 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 21151 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 21152 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 21153 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 21154 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 21155 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 21156 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 21157 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 21158 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 21159 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 21160 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 21161 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 21162 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 21163 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 21164 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 21165 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 21166 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 21167 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 21168 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 21169 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 21170 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 21171 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 21172 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 21173 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 21174 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 21175 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 21176 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 21177 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 21178 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 21179 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 21180 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 21181 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 21182 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 21183 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 21184 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 21185 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 21186 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 21187 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 21188 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 21189 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 21190 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 21191 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 21192 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 21193 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 21194 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 21195 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 21196 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 21197 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 21198 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 21199 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 21200 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 21201 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 21202 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 21203 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 21204 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 21205 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 21206 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 21207 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 21208 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 21209 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 21210 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 21211 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 21212 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 21213 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 21214 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 21215 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 21216 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 21217 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 21218 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 21219 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 21220 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 21221 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 21222 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 21223 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 21224 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 21225 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 21226 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 21227 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 21228 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 21229 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 21230 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 21231 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 21232 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 21233 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 21234 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 21235 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 21236 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 21237 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 21238 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 21239 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 21240 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 21241 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 21242 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 21243 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 21244 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 21245 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 21246 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 21247 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 21248 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 21249 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 21250 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 21251 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 21252 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 21253 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 21254 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 21255 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 21256 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 21257 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 21258 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 21259 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 21260 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 21261 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 21262 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 21263 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 21264 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 21265 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 21266 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 21267 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 21268 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 21269 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 21270 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 21271 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 21272 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 21273 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 21274 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 21275 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 21276 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 21277 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 21278 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 21279 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 21280 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 21281 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 21282 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 21283 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 21284 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 21285 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 21286 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 21287 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 21288 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 21289 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 21290 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 21291 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 21292 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 21293 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 21294 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 21295 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 21296 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 21297 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 21298 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 21299 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 21300 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 21301 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 21302 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 21303 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 21304 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 21305 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 21306 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 21307 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 21308 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 21309 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 21310 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 21311 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 21312 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 21313 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 21314 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 21315 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 21316 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 21317 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 21318 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 21319 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 21320 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 21321 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 21322 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 21323 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 21324 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 21325 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 21326 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 21327 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 21328 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 21329 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 21330 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 21331 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 21332 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 21333 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 21334 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 21335 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 21336 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 21337 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 21338 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 21339 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 21340 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 21341 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 21342 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 21343 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 21344 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 21345 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 21346 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 21347 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 21348 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 21349 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 21350 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 21351 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 21352 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 21353 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 21354 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 21355 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 21356 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 21357 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 21358 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 21359 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 21360 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 21361 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 21362 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 21363 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 21364 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 21365 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 21366 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 21367 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 21368 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 21369 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 21370 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 21371 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 21372 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 21373 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 21374 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 21375 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 21376 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 21377 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 21378 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 21379 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 21380 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 21381 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 21382 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 21383 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 21384 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 21385 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 21386 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 21387 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 21388 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 21389 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 21390 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 21391 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 21392 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 21393 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 21394 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 21395 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 21396 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 21397 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 21398 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 21399 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 21400 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 21401 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 21402 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 21403 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 21404 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 21405 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 21406 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 21407 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 21408 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 21409 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 21410 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 21411 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 21412 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 21413 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 21414 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 21415 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 21416 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 21417 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 21418 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 21419 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 21420 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 21421 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 21422 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 21423 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 21424 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 21425 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 21426 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 21427 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 21428 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 21429 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 21430 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 21431 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 21432 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 21433 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 21434 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 21435 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 21436 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 21437 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 21438 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 21439 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 21440 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 21441 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 21442 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 21443 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 21444 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 21445 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 21446 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 21447 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 21448 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 21449 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 21450 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 21451 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 21452 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 21453 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 21454 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 21455 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 21456 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 21457 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 21458 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 21459 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 21460 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 21461 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 21462 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 21463 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 21464 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 21465 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 21466 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 21467 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 21468 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 21469 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 21470 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 21471 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 21472 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 21473 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 21474 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 21475 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 21476 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 21477 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 21478 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 21479 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 21480 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 21481 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 21482 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 21483 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 21484 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 21485 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 21486 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 21487 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 21488 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 21489 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 21490 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 21491 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 21492 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 21493 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 21494 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 21495 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 21496 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 21497 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 21498 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 21499 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 21500 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 21501 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 21502 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 21503 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 21504 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 21505 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 21506 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 21507 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 21508 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 21509 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 21510 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 21511 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 21512 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 21513 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 21514 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 21515 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 21516 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 21517 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 21518 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 21519 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 21520 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 21521 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 21522 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 21523 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 21524 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 21525 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 21526 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 21527 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 21528 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 21529 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 21530 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 21531 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 21532 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 21533 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 21534 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 21535 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 21536 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 21537 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 21538 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 21539 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 21540 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 21541 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 21542 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 21543 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 21544 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 21545 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 21546 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 21547 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 21548 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 21549 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 21550 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 21551 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 21552 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 21553 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 21554 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 21555 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 21556 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 21557 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 21558 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 21559 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 21560 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 21561 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 21562 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 21563 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 21564 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 21565 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 21566 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 21567 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 21568 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 21569 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 21570 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 21571 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 21572 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 21573 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 21574 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 21575 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 21576 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 21577 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 21578 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 21579 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 21580 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 21581 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 21582 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 21583 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 21584 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 21585 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 21586 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 21587 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 21588 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 21589 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 21590 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 21591 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 21592 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 21593 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 21594 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 21595 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 21596 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 21597 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 21598 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 21599 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 21600 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 21601 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 21602 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 21603 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 21604 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 21605 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 21606 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 21607 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 21608 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 21609 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 21610 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 21611 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 21612 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 21613 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 21614 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 21615 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 21616 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 21617 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 21618 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 21619 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 21620 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 21621 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 21622 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 21623 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 21624 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 21625 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 21626 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 21627 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 21628 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 21629 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 21630 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 21631 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 21632 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 21633 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 21634 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 21635 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 21636 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 21637 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 21638 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 21639 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 21640 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 21641 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 21642 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 21643 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 21644 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 21645 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 21646 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 21647 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 21648 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 21649 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 21650 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 21651 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 21652 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 21653 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 21654 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 21655 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 21656 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 21657 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 21658 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 21659 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 21660 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 21661 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 21662 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 21663 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 21664 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 21665 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 21666 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 21667 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 21668 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 21669 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 21670 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 21671 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 21672 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 21673 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 21674 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 21675 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 21676 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 21677 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 21678 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 21679 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 21680 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 21681 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 21682 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 21683 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 21684 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 21685 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 21686 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 21687 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 21688 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 21689 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 21690 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 21691 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 21692 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 21693 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 21694 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 21695 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 21696 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 21697 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 21698 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 21699 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 21700 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 21701 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 21702 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 21703 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 21704 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 21705 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 21706 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 21707 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 21708 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 21709 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 21710 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 21711 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 21712 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 21713 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 21714 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 21715 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 21716 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 21717 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 21718 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 21719 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 21720 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 21721 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 21722 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 21723 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 21724 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 21725 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 21726 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 21727 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 21728 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 21729 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 21730 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 21731 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 21732 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 21733 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 21734 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 21735 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 21736 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 21737 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 21738 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 21739 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 21740 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 21741 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 21742 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 21743 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 21744 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 21745 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 21746 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 21747 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 21748 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 21749 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 21750 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 21751 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 21752 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 21753 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 21754 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 21755 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 21756 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 21757 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 21758 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 21759 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 21760 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 21761 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 21762 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 21763 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 21764 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 21765 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 21766 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 21767 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 21768 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 21769 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 21770 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 21771 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 21772 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 21773 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 21774 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 21775 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 21776 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 21777 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 21778 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 21779 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 21780 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 21781 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 21782 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 21783 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 21784 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 21785 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 21786 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 21787 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 21788 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 21789 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 21790 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 21791 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 21792 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 21793 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 21794 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 21795 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 21796 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 21797 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 21798 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 21799 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 21800 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 21801 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 21802 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 21803 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 21804 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 21805 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 21806 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 21807 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 21808 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 21809 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 21810 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 21811 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 21812 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 21813 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 21814 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 21815 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 21816 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 21817 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 21818 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 21819 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 21820 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 21821 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 21822 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 21823 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 21824 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 21825 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 21826 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 21827 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 21828 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 21829 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 21830 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 21831 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 21832 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 21833 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 21834 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 21835 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 21836 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 21837 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 21838 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 21839 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 21840 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 21841 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 21842 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 21843 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 21844 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 21845 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 21846 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 21847 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 21848 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 21849 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 21850 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 21851 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 21852 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 21853 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 21854 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 21855 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 21856 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 21857 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 21858 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 21859 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 21860 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 21861 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 21862 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 21863 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 21864 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 21865 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 21866 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 21867 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 21868 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 21869 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 21870 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 21871 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 21872 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 21873 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 21874 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 21875 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 21876 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 21877 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 21878 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 21879 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 21880 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 21881 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 21882 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 21883 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 21884 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 21885 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 21886 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 21887 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 21888 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 21889 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 21890 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 21891 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 21892 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 21893 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 21894 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 21895 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 21896 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 21897 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 21898 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 21899 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 21900 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 21901 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 21902 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 21903 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 21904 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 21905 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 21906 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 21907 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 21908 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 21909 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 21910 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 21911 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 21912 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 21913 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 21914 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 21915 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 21916 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 21917 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 21918 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 21919 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 21920 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 21921 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 21922 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 21923 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 21924 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 21925 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 21926 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 21927 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 21928 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 21929 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 21930 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 21931 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 21932 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 21933 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 21934 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 21935 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 21936 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 21937 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 21938 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 21939 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 21940 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 21941 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 21942 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 21943 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 21944 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 21945 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 21946 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 21947 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 21948 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 21949 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 21950 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 21951 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 21952 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 21953 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 21954 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 21955 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 21956 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 21957 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 21958 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 21959 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 21960 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 21961 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 21962 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 21963 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 21964 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 21965 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 21966 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 21967 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 21968 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 21969 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 21970 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 21971 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 21972 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 21973 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 21974 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 21975 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 21976 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 21977 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 21978 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 21979 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 21980 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 21981 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 21982 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 21983 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 21984 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 21985 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 21986 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 21987 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 21988 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 21989 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 21990 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 21991 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 21992 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 21993 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 21994 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 21995 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 21996 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 21997 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 21998 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 21999 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 22000 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 22001 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 22002 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 22003 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 22004 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 22005 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 22006 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 22007 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 22008 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 22009 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 22010 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 22011 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 22012 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 22013 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 22014 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 22015 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 22016 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 22017 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 22018 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 22019 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 22020 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 22021 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 22022 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 22023 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 22024 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 22025 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 22026 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 22027 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 22028 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 22029 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 22030 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 22031 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 22032 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 22033 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 22034 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 22035 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 22036 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 22037 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 22038 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 22039 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 22040 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 22041 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 22042 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 22043 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 22044 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 22045 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 22046 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 22047 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 22048 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 22049 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 22050 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 22051 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 22052 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 22053 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 22054 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 22055 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 22056 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 22057 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 22058 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 22059 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 22060 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 22061 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 22062 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 22063 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 22064 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 22065 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 22066 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 22067 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 22068 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 22069 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 22070 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 22071 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 22072 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 22073 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 22074 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 22075 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 22076 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 22077 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 22078 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 22079 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 22080 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 22081 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 22082 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 22083 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 22084 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 22085 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 22086 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 22087 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 22088 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 22089 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 22090 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 22091 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 22092 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 22093 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 22094 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 22095 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 22096 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 22097 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 22098 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 22099 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 22100 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 22101 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 22102 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 22103 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 22104 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 22105 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 22106 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 22107 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 22108 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 22109 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 22110 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 22111 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 22112 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 22113 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 22114 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 22115 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 22116 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 22117 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 22118 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 22119 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 22120 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 22121 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 22122 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 22123 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 22124 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 22125 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 22126 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 22127 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 22128 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 22129 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 22130 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 22131 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 22132 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 22133 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 22134 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 22135 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 22136 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 22137 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 22138 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 22139 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 22140 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 22141 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 22142 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 22143 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 22144 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 22145 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 22146 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 22147 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 22148 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 22149 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 22150 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 22151 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 22152 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 22153 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 22154 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 22155 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 22156 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 22157 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 22158 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 22159 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 22160 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 22161 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 22162 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 22163 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 22164 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 22165 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 22166 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 22167 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 22168 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 22169 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 22170 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 22171 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 22172 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 22173 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 22174 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 22175 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 22176 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 22177 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 22178 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 22179 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 22180 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 22181 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 22182 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 22183 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 22184 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 22185 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 22186 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 22187 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 22188 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 22189 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 22190 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 22191 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 22192 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 22193 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 22194 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 22195 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 22196 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 22197 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 22198 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 22199 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 22200 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 22201 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 22202 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 22203 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 22204 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 22205 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 22206 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 22207 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 22208 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 22209 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 22210 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 22211 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 22212 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 22213 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 22214 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 22215 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 22216 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 22217 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 22218 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 22219 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 22220 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 22221 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 22222 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 22223 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 22224 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 22225 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 22226 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 22227 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 22228 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 22229 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 22230 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 22231 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 22232 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 22233 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 22234 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 22235 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 22236 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 22237 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 22238 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 22239 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 22240 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 22241 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 22242 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 22243 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 22244 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 22245 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 22246 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 22247 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 22248 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 22249 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 22250 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 22251 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 22252 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 22253 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 22254 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 22255 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 22256 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 22257 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 22258 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 22259 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 22260 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 22261 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 22262 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 22263 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 22264 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 22265 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 22266 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 22267 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 22268 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 22269 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 22270 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 22271 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 22272 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 22273 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 22274 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 22275 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 22276 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 22277 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 22278 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 22279 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 22280 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 22281 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 22282 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 22283 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 22284 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 22285 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 22286 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 22287 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 22288 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 22289 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 22290 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 22291 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 22292 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 22293 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 22294 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 22295 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 22296 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 22297 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 22298 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 22299 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 22300 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 22301 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 22302 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 22303 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 22304 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 22305 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 22306 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 22307 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 22308 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 22309 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 22310 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 22311 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 22312 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 22313 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 22314 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 22315 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 22316 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 22317 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 22318 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 22319 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 22320 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 22321 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 22322 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 22323 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 22324 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 22325 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 22326 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 22327 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 22328 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 22329 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 22330 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 22331 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 22332 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 22333 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 22334 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 22335 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 22336 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 22337 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 22338 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 22339 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 22340 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 22341 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 22342 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 22343 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 22344 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 22345 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 22346 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 22347 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 22348 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 22349 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 22350 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 22351 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 22352 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 22353 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 22354 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 22355 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 22356 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 22357 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 22358 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 22359 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 22360 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 22361 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 22362 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 22363 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 22364 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 22365 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 22366 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 22367 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 22368 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 22369 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 22370 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 22371 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 22372 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 22373 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 22374 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 22375 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 22376 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 22377 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 22378 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 22379 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 22380 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 22381 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 22382 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 22383 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 22384 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 22385 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 22386 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 22387 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 22388 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 22389 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 22390 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 22391 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 22392 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 22393 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 22394 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 22395 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 22396 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 22397 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 22398 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 22399 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 22400 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 22401 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 22402 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 22403 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 22404 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 22405 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 22406 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 22407 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 22408 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 22409 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 22410 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 22411 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 22412 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 22413 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 22414 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 22415 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 22416 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 22417 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 22418 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 22419 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 22420 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 22421 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 22422 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 22423 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 22424 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 22425 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 22426 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 22427 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 22428 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 22429 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 22430 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 22431 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 22432 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 22433 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 22434 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 22435 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 22436 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 22437 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 22438 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 22439 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 22440 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 22441 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 22442 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 22443 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 22444 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 22445 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 22446 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 22447 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 22448 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 22449 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 22450 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 22451 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 22452 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 22453 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 22454 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 22455 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 22456 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 22457 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 22458 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 22459 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 22460 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 22461 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 22462 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 22463 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 22464 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 22465 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 22466 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 22467 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 22468 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 22469 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 22470 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 22471 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 22472 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 22473 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 22474 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 22475 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 22476 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 22477 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 22478 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 22479 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 22480 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 22481 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 22482 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 22483 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 22484 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 22485 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 22486 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 22487 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 22488 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 22489 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 22490 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 22491 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 22492 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 22493 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 22494 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 22495 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 22496 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 22497 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 22498 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 22499 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 22500 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 22501 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 22502 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 22503 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 22504 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 22505 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 22506 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 22507 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 22508 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 22509 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 22510 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 22511 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 22512 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 22513 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 22514 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 22515 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 22516 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 22517 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 22518 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 22519 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 22520 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 22521 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 22522 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 22523 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 22524 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 22525 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 22526 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 22527 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 22528 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 22529 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 22530 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 22531 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 22532 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 22533 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 22534 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 22535 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 22536 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 22537 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 22538 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 22539 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 22540 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 22541 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 22542 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 22543 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 22544 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 22545 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 22546 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 22547 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 22548 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 22549 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 22550 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 22551 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 22552 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 22553 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 22554 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 22555 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 22556 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 22557 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 22558 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 22559 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 22560 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 22561 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 22562 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 22563 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 22564 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 22565 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 22566 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 22567 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 22568 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 22569 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 22570 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 22571 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 22572 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 22573 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 22574 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 22575 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 22576 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 22577 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 22578 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 22579 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 22580 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 22581 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 22582 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 22583 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 22584 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 22585 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 22586 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 22587 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 22588 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 22589 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 22590 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 22591 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 22592 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 22593 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 22594 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 22595 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 22596 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 22597 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 22598 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 22599 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 22600 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 22601 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 22602 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 22603 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 22604 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 22605 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 22606 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 22607 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 22608 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 22609 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 22610 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 22611 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 22612 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 22613 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 22614 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 22615 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 22616 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 22617 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 22618 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 22619 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 22620 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 22621 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 22622 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 22623 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 22624 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 22625 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 22626 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 22627 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 22628 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 22629 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 22630 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 22631 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 22632 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 22633 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 22634 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 22635 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 22636 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 22637 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 22638 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 22639 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 22640 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 22641 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 22642 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 22643 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 22644 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 22645 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 22646 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 22647 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 22648 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 22649 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 22650 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 22651 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 22652 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 22653 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 22654 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 22655 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 22656 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 22657 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 22658 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 22659 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 22660 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 22661 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 22662 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 22663 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 22664 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 22665 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 22666 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 22667 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 22668 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 22669 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 22670 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 22671 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 22672 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 22673 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 22674 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 22675 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 22676 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 22677 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 22678 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 22679 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 22680 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 22681 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 22682 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 22683 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 22684 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 22685 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 22686 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 22687 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 22688 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 22689 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 22690 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 22691 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 22692 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 22693 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 22694 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 22695 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 22696 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 22697 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 22698 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 22699 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 22700 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 22701 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 22702 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 22703 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 22704 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 22705 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 22706 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 22707 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 22708 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 22709 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 22710 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 22711 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 22712 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 22713 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 22714 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 22715 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 22716 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 22717 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 22718 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 22719 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 22720 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 22721 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 22722 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 22723 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 22724 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 22725 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 22726 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 22727 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 22728 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 22729 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 22730 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 22731 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 22732 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 22733 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 22734 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 22735 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 22736 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 22737 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 22738 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 22739 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 22740 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 22741 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 22742 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 22743 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 22744 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 22745 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 22746 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 22747 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 22748 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 22749 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 22750 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 22751 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 22752 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 22753 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 22754 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 22755 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 22756 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 22757 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 22758 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 22759 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 22760 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 22761 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 22762 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 22763 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 22764 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 22765 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 22766 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 22767 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 22768 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 22769 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 22770 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 22771 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 22772 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 22773 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 22774 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 22775 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 22776 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 22777 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 22778 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 22779 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 22780 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 22781 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 22782 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 22783 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 22784 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 22785 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 22786 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 22787 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 22788 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 22789 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 22790 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 22791 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 22792 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 22793 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 22794 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 22795 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 22796 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 22797 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 22798 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 22799 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 22800 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 22801 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 22802 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 22803 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 22804 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 22805 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 22806 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 22807 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 22808 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 22809 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 22810 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 22811 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 22812 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 22813 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 22814 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 22815 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 22816 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 22817 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 22818 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 22819 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 22820 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 22821 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 22822 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 22823 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 22824 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 22825 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 22826 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 22827 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 22828 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 22829 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 22830 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 22831 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 22832 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 22833 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 22834 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 22835 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 22836 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 22837 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 22838 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 22839 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 22840 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 22841 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 22842 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 22843 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 22844 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 22845 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 22846 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 22847 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 22848 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 22849 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 22850 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 22851 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 22852 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 22853 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 22854 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 22855 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 22856 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 22857 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 22858 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 22859 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 22860 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 22861 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 22862 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 22863 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 22864 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 22865 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 22866 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 22867 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 22868 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 22869 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 22870 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 22871 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 22872 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 22873 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 22874 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 22875 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 22876 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 22877 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 22878 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 22879 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 22880 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 22881 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 22882 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 22883 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 22884 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 22885 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 22886 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 22887 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 22888 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 22889 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 22890 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 22891 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 22892 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 22893 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 22894 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 22895 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 22896 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 22897 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 22898 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 22899 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 22900 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 22901 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 22902 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 22903 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 22904 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 22905 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 22906 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 22907 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 22908 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 22909 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 22910 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 22911 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 22912 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 22913 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 22914 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 22915 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 22916 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 22917 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 22918 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 22919 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 22920 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 22921 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 22922 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 22923 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 22924 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 22925 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 22926 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 22927 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 22928 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 22929 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 22930 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 22931 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 22932 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 22933 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 22934 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 22935 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 22936 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 22937 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 22938 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 22939 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 22940 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 22941 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 22942 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 22943 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 22944 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 22945 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 22946 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 22947 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 22948 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 22949 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 22950 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 22951 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 22952 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 22953 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 22954 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 22955 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 22956 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 22957 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 22958 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 22959 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 22960 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 22961 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 22962 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 22963 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 22964 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 22965 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 22966 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 22967 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 22968 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 22969 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 22970 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 22971 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 22972 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 22973 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 22974 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 22975 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 22976 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 22977 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 22978 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 22979 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 22980 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 22981 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 22982 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 22983 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 22984 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 22985 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 22986 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 22987 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 22988 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 22989 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 22990 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 22991 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 22992 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 22993 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 22994 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 22995 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 22996 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 22997 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 22998 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 22999 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 23000 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 23001 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 23002 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 23003 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 23004 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 23005 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 23006 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 23007 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 23008 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 23009 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 23010 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 23011 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 23012 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 23013 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 23014 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 23015 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 23016 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 23017 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 23018 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 23019 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 23020 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 23021 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 23022 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 23023 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 23024 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 23025 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 23026 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 23027 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 23028 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 23029 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 23030 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 23031 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 23032 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 23033 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 23034 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 23035 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 23036 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 23037 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 23038 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 23039 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 23040 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 23041 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 23042 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 23043 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 23044 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 23045 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 23046 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 23047 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 23048 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 23049 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 23050 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 23051 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 23052 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 23053 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 23054 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 23055 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 23056 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 23057 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 23058 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 23059 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 23060 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 23061 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 23062 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 23063 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 23064 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 23065 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 23066 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 23067 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 23068 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 23069 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 23070 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 23071 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 23072 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 23073 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 23074 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 23075 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 23076 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 23077 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 23078 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 23079 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 23080 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 23081 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 23082 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 23083 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 23084 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 23085 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 23086 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 23087 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 23088 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 23089 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 23090 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 23091 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 23092 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 23093 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 23094 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 23095 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 23096 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 23097 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 23098 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 23099 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 23100 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 23101 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 23102 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 23103 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 23104 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 23105 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 23106 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 23107 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 23108 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 23109 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 23110 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 23111 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 23112 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 23113 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 23114 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 23115 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 23116 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 23117 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 23118 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 23119 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 23120 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 23121 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 23122 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 23123 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 23124 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 23125 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 23126 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 23127 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 23128 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 23129 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 23130 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 23131 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 23132 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 23133 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 23134 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 23135 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 23136 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 23137 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 23138 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 23139 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 23140 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 23141 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 23142 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 23143 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 23144 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 23145 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 23146 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 23147 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 23148 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 23149 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 23150 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 23151 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 23152 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 23153 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 23154 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 23155 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 23156 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 23157 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 23158 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 23159 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 23160 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 23161 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 23162 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 23163 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 23164 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 23165 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 23166 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 23167 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 23168 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 23169 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 23170 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 23171 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 23172 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 23173 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 23174 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 23175 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 23176 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 23177 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 23178 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 23179 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 23180 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 23181 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 23182 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 23183 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 23184 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 23185 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 23186 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 23187 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 23188 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 23189 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 23190 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 23191 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 23192 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 23193 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 23194 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 23195 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 23196 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 23197 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 23198 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 23199 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 23200 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 23201 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 23202 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 23203 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 23204 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 23205 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 23206 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 23207 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 23208 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 23209 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 23210 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 23211 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 23212 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 23213 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 23214 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 23215 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 23216 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 23217 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 23218 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 23219 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 23220 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 23221 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 23222 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 23223 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 23224 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 23225 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 23226 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 23227 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 23228 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 23229 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 23230 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 23231 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 23232 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 23233 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 23234 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 23235 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 23236 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 23237 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 23238 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 23239 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 23240 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 23241 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 23242 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 23243 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 23244 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 23245 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 23246 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 23247 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 23248 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 23249 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 23250 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 23251 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 23252 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 23253 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 23254 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 23255 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 23256 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 23257 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 23258 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 23259 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 23260 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 23261 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 23262 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 23263 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 23264 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 23265 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 23266 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 23267 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 23268 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 23269 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 23270 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 23271 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 23272 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 23273 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 23274 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 23275 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 23276 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 23277 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 23278 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 23279 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 23280 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 23281 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 23282 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 23283 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 23284 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 23285 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 23286 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 23287 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 23288 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 23289 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 23290 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 23291 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 23292 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 23293 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 23294 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 23295 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 23296 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 23297 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 23298 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 23299 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 23300 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 23301 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 23302 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 23303 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 23304 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 23305 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 23306 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 23307 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 23308 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 23309 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 23310 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 23311 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 23312 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 23313 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 23314 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 23315 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 23316 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 23317 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 23318 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 23319 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 23320 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 23321 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 23322 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 23323 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 23324 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 23325 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 23326 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 23327 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 23328 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 23329 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 23330 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 23331 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 23332 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 23333 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 23334 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 23335 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 23336 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 23337 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 23338 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 23339 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 23340 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 23341 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 23342 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 23343 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 23344 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 23345 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 23346 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 23347 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 23348 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 23349 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 23350 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 23351 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 23352 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 23353 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 23354 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 23355 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 23356 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 23357 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 23358 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 23359 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 23360 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 23361 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 23362 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 23363 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 23364 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 23365 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 23366 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 23367 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 23368 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 23369 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 23370 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 23371 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 23372 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 23373 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 23374 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 23375 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 23376 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 23377 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 23378 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 23379 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 23380 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 23381 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 23382 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 23383 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 23384 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 23385 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 23386 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 23387 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 23388 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 23389 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 23390 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 23391 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 23392 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 23393 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 23394 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 23395 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 23396 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 23397 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 23398 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 23399 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 23400 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 23401 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 23402 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 23403 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 23404 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 23405 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 23406 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 23407 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 23408 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 23409 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 23410 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 23411 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 23412 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 23413 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 23414 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 23415 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 23416 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 23417 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 23418 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 23419 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 23420 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 23421 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 23422 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 23423 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 23424 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 23425 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 23426 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 23427 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 23428 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 23429 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 23430 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 23431 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 23432 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 23433 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 23434 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 23435 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 23436 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 23437 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 23438 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 23439 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 23440 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 23441 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 23442 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 23443 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 23444 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 23445 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 23446 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 23447 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 23448 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 23449 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 23450 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 23451 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 23452 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 23453 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 23454 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 23455 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 23456 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 23457 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 23458 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 23459 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 23460 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 23461 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 23462 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 23463 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 23464 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 23465 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 23466 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 23467 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 23468 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 23469 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 23470 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 23471 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 23472 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 23473 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 23474 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 23475 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 23476 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 23477 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 23478 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 23479 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 23480 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 23481 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 23482 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 23483 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 23484 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 23485 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 23486 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 23487 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 23488 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 23489 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 23490 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 23491 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 23492 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 23493 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 23494 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 23495 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 23496 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 23497 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 23498 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 23499 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 23500 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 23501 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 23502 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 23503 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 23504 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 23505 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 23506 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 23507 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 23508 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 23509 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 23510 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 23511 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 23512 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 23513 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 23514 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 23515 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 23516 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 23517 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 23518 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 23519 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 23520 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 23521 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 23522 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 23523 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 23524 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 23525 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 23526 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 23527 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 23528 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 23529 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 23530 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 23531 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 23532 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 23533 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 23534 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 23535 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 23536 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 23537 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 23538 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 23539 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 23540 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 23541 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 23542 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 23543 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 23544 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 23545 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 23546 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 23547 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 23548 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 23549 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 23550 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 23551 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 23552 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 23553 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 23554 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 23555 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 23556 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 23557 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 23558 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 23559 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 23560 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 23561 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 23562 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 23563 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 23564 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 23565 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 23566 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 23567 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 23568 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 23569 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 23570 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 23571 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 23572 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 23573 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 23574 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 23575 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 23576 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 23577 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 23578 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 23579 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 23580 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 23581 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 23582 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 23583 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 23584 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 23585 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 23586 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 23587 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 23588 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 23589 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 23590 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 23591 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 23592 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 23593 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 23594 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 23595 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 23596 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 23597 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 23598 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 23599 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 23600 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 23601 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 23602 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 23603 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 23604 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 23605 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 23606 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 23607 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 23608 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 23609 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 23610 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 23611 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 23612 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 23613 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 23614 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 23615 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 23616 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 23617 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 23618 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 23619 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 23620 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 23621 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 23622 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 23623 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 23624 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 23625 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 23626 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 23627 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 23628 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 23629 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 23630 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 23631 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 23632 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 23633 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 23634 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 23635 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 23636 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 23637 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 23638 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 23639 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 23640 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 23641 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 23642 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 23643 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 23644 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 23645 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 23646 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 23647 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 23648 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 23649 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 23650 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 23651 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 23652 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 23653 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 23654 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 23655 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 23656 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 23657 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 23658 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 23659 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 23660 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 23661 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 23662 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 23663 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 23664 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 23665 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 23666 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 23667 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 23668 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 23669 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 23670 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 23671 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 23672 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 23673 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 23674 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 23675 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 23676 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 23677 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 23678 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 23679 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 23680 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 23681 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 23682 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 23683 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 23684 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 23685 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 23686 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 23687 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 23688 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 23689 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 23690 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 23691 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 23692 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 23693 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 23694 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 23695 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 23696 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 23697 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 23698 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 23699 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 23700 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 23701 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 23702 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 23703 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 23704 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 23705 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 23706 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 23707 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 23708 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 23709 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 23710 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 23711 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 23712 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 23713 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 23714 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 23715 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 23716 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 23717 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 23718 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 23719 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 23720 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 23721 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 23722 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 23723 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 23724 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 23725 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 23726 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 23727 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 23728 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 23729 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 23730 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 23731 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 23732 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 23733 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 23734 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 23735 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 23736 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 23737 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 23738 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 23739 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 23740 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 23741 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 23742 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 23743 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 23744 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 23745 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 23746 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 23747 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 23748 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 23749 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 23750 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 23751 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 23752 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 23753 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 23754 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 23755 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 23756 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 23757 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 23758 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 23759 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 23760 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 23761 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 23762 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 23763 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 23764 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 23765 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 23766 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 23767 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 23768 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 23769 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 23770 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 23771 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 23772 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 23773 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 23774 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 23775 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 23776 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 23777 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 23778 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 23779 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 23780 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 23781 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 23782 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 23783 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 23784 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 23785 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 23786 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 23787 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 23788 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 23789 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 23790 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 23791 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 23792 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 23793 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 23794 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 23795 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 23796 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 23797 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 23798 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 23799 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 23800 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 23801 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 23802 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 23803 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 23804 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 23805 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 23806 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 23807 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 23808 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 23809 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 23810 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 23811 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 23812 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 23813 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 23814 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 23815 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 23816 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 23817 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 23818 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 23819 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 23820 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 23821 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 23822 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 23823 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 23824 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 23825 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 23826 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 23827 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 23828 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 23829 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 23830 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 23831 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 23832 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 23833 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 23834 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 23835 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 23836 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 23837 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 23838 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 23839 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 23840 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 23841 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 23842 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 23843 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 23844 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 23845 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 23846 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 23847 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 23848 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 23849 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 23850 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 23851 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 23852 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 23853 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 23854 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 23855 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 23856 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 23857 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 23858 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 23859 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 23860 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 23861 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 23862 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 23863 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 23864 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 23865 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 23866 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 23867 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 23868 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 23869 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 23870 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 23871 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 23872 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 23873 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 23874 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 23875 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 23876 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 23877 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 23878 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 23879 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 23880 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 23881 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 23882 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 23883 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 23884 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 23885 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 23886 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 23887 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 23888 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 23889 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 23890 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 23891 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 23892 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 23893 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 23894 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 23895 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 23896 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 23897 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 23898 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 23899 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 23900 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 23901 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 23902 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 23903 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 23904 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 23905 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 23906 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 23907 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 23908 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 23909 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 23910 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 23911 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 23912 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 23913 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 23914 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 23915 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 23916 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 23917 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 23918 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 23919 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 23920 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 23921 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 23922 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 23923 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 23924 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 23925 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 23926 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 23927 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 23928 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 23929 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 23930 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 23931 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 23932 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 23933 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 23934 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 23935 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 23936 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 23937 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 23938 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 23939 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 23940 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 23941 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 23942 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 23943 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 23944 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 23945 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 23946 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 23947 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 23948 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 23949 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 23950 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 23951 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 23952 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 23953 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 23954 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 23955 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 23956 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 23957 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 23958 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 23959 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 23960 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 23961 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 23962 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 23963 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 23964 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 23965 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 23966 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 23967 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 23968 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 23969 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 23970 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 23971 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 23972 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 23973 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 23974 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 23975 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 23976 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 23977 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 23978 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 23979 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 23980 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 23981 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 23982 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 23983 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 23984 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 23985 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 23986 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 23987 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 23988 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 23989 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 23990 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 23991 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 23992 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 23993 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 23994 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 23995 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 23996 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 23997 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 23998 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 23999 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 24000 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 24001 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 24002 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 24003 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 24004 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 24005 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 24006 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 24007 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 24008 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 24009 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 24010 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 24011 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 24012 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 24013 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 24014 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 24015 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 24016 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 24017 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 24018 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 24019 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 24020 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 24021 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 24022 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 24023 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 24024 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 24025 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 24026 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 24027 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 24028 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 24029 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 24030 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 24031 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 24032 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 24033 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 24034 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 24035 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 24036 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 24037 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 24038 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 24039 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 24040 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 24041 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 24042 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 24043 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 24044 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 24045 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 24046 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 24047 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 24048 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 24049 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 24050 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 24051 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 24052 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 24053 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 24054 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 24055 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 24056 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 24057 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 24058 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 24059 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 24060 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 24061 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 24062 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 24063 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 24064 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 24065 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 24066 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 24067 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 24068 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 24069 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 24070 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 24071 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 24072 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 24073 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 24074 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 24075 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 24076 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 24077 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 24078 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 24079 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 24080 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 24081 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 24082 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 24083 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 24084 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 24085 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 24086 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 24087 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 24088 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 24089 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 24090 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 24091 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 24092 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 24093 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 24094 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 24095 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 24096 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 24097 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 24098 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 24099 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 24100 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 24101 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 24102 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 24103 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 24104 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 24105 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 24106 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 24107 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 24108 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 24109 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 24110 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 24111 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 24112 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 24113 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 24114 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 24115 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 24116 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 24117 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 24118 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 24119 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 24120 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 24121 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 24122 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 24123 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 24124 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 24125 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 24126 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 24127 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 24128 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 24129 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 24130 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 24131 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 24132 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 24133 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 24134 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 24135 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 24136 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 24137 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 24138 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 24139 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 24140 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 24141 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 24142 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 24143 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 24144 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 24145 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 24146 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 24147 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 24148 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 24149 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 24150 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 24151 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 24152 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 24153 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 24154 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 24155 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 24156 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 24157 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 24158 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 24159 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 24160 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 24161 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 24162 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 24163 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 24164 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 24165 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 24166 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 24167 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 24168 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 24169 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 24170 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 24171 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 24172 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 24173 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 24174 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 24175 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 24176 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 24177 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 24178 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 24179 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 24180 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 24181 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 24182 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 24183 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 24184 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 24185 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 24186 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 24187 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 24188 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 24189 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 24190 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 24191 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 24192 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 24193 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 24194 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 24195 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 24196 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 24197 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 24198 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 24199 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 24200 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 24201 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 24202 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 24203 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 24204 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 24205 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 24206 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 24207 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 24208 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 24209 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 24210 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 24211 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 24212 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 24213 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 24214 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 24215 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 24216 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 24217 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 24218 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 24219 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 24220 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 24221 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 24222 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 24223 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 24224 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 24225 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 24226 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 24227 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 24228 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 24229 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 24230 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 24231 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 24232 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 24233 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 24234 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 24235 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 24236 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 24237 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 24238 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 24239 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 24240 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 24241 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 24242 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 24243 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 24244 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 24245 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 24246 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 24247 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 24248 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 24249 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 24250 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 24251 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 24252 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 24253 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 24254 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 24255 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 24256 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 24257 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 24258 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 24259 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 24260 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 24261 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 24262 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 24263 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 24264 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 24265 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 24266 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 24267 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 24268 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 24269 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 24270 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 24271 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 24272 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 24273 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 24274 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 24275 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 24276 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 24277 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 24278 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 24279 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 24280 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 24281 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 24282 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 24283 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 24284 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 24285 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 24286 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 24287 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 24288 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 24289 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 24290 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 24291 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 24292 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 24293 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 24294 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 24295 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 24296 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 24297 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 24298 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 24299 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 24300 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 24301 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 24302 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 24303 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 24304 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 24305 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 24306 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 24307 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 24308 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 24309 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 24310 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 24311 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 24312 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 24313 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 24314 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 24315 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 24316 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 24317 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 24318 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 24319 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 24320 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 24321 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 24322 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 24323 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 24324 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 24325 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 24326 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 24327 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 24328 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 24329 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 24330 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 24331 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 24332 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 24333 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 24334 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 24335 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 24336 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 24337 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 24338 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 24339 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 24340 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 24341 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 24342 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 24343 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 24344 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 24345 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 24346 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 24347 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 24348 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 24349 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK
